United States Patent 12,723,248 (RNAi CONSTRUCTS FOR INHIBITING ASGR1 EXPRESSION AND METHODS OF USE THEREOF) - sequence listing, part 2

SEQ ID NO: 4571 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gggcccgttttggtcgtggtt

SEQ ID NO: 4572 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gaggcccagggagagcaggtt

SEQ ID NO: 4573 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gcccagggagagcaggaggtt

SEQ ID NO: 4574 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cgacttcatctttcttccctt

SEQ ID NO: 4575 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gccgtcgtcggtgaagtggtt

SEQ ID NO: 4576 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cgagagaaccagtagcagctt

SEQ ID NO: 4577 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cccacttccagggcccgtttt

SEQ ID NO: 4578 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
taccagtcgtccggctgcttt

SEQ ID NO: 4579 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtccagctctgtctcgcagtt

SEQ ID NO: 4580 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
caccaggtgcgcgtcctcctt

SEQ ID NO: 4581 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tgctcctcccaggacgtgatt

SEQ ID NO: 4582 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gaccgggcagcaggtcctttt

SEQ ID NO: 4583 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ctgaagcttggagaatgggtt

SEQ ID NO: 4584 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tttggtcgtggaggcccattt

SEQ ID NO: 4585 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtcgttccagcggccgtcgtt

SEQ ID NO: 4586 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ccggagcgagagaaccagttt

SEQ ID NO: 4587 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ccagggcccgttttggtcgtt

SEQ ID NO: 4588 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cagctctgtctcgcagacctt

SEQ ID NO: 4589 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
tctcgtagtccgtcccgtctt

SEQ ID NO: 4590 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
aattaaaggagaggtggcttt

SEQ ID NO: 4591 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gctcaggctccgcaggtcatt

SEQ ID NO: 4592 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gaggcccagggagagcaggtt

SEQ ID NO: 4593 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gcccagggagagcaggaggtt

SEQ ID NO: 4594 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
cgagagaaccagtagcagctt

SEQ ID NO: 4595 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
ctgaagcttggagaatgggtt

SEQ ID NO: 4596 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
ccggagcgagagaaccagttt

SEQ ID NO: 4597 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4598 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acttcatctttcttcccactt

SEQ ID NO: 4599 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4600 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4601 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acttcatctttcttcccactt

SEQ ID NO: 4602 - RNA, 21 nt, synthetic construct
  source 1..21: mol_type = other RNA
  modified_base 1: mod_base = OTHER; note = 5'-monophosphate
  modified_base 1..2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acttcatctttcttcccactt

SEQ ID NO: 4603 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acttcatctttcttcccactt

SEQ ID NO: 4604 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
acttcatctttcttcccactt

SEQ ID NO: 4605 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cttcatctttcttcccacatt

SEQ ID NO: 4606 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20..21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4607 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13..14: mod_base = OTHER; note = 2'-O-methyl ribonucleotide
  modified_base 15..16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4608 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15..16: mod_base = OTHER; note = 2'-O-methyl ribonucleotide
  modified_base 17..18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4609 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17..18: mod_base = OTHER; note = 2'-O-methyl ribonucleotide
  modified_base 19..21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4610 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4..5: mod_base = OTHER; note = 2'-deoxy-2'-fluoro ribonucleotide
  modified_base 6..7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4611 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2..3: mod_base = OTHER; note = 2'-deoxy-2'-fluoro ribonucleotide
  modified_base 4..5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4612 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2..3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4613 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4614 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4615 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20..21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4616 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20..21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4617 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5..6: mod_base = OTHER; note = 2'-O-methyl ribonucleotide
  modified_base 7..8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4618 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acgtcgtcgttccagcggctt

SEQ ID NO: 4619 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ttcggaacatcaccctatctt

SEQ ID NO: 4620 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
actccttggtcatgataggtt

SEQ ID NO: 4621 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tactccttggtcatgatagtt

SEQ ID NO: 4622 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cccacttccagggcccgtttt

SEQ ID NO: 4623 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tctcgtagtccgtcccgtctt

SEQ ID NO: 4624 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtctcgtagtccgtcccgttt

SEQ ID NO: 4625 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
taccagtcgtccggctgcttt

SEQ ID NO: 4626 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gccgtcgtcggtgaagtggtt

SEQ ID NO: 4627 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtcgttccagcggccgtcgtt

SEQ ID NO: 4628 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cagaaagcgccacgggttttt

SEQ ID NO: 4629 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cccgagaaagcagaagaggtt

SEQ ID NO: 4630 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agaaagcgccacgggtttctt

SEQ ID NO: 4631 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtgctggacaaatttctgctt

SEQ ID NO: 4632 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gaagcccgtctcgtagtcctt

SEQ ID NO: 4633 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tcgtcggtgaagtgggcactt

SEQ ID NO: 4634 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
atccgatcacacagacaactt

SEQ ID NO: 4635 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cagctctgtctcgcagacctt

SEQ ID NO: 4636 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
aattaaaggagaggtggcttt

SEQ ID NO: 4637 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gaactgcttcacgtggagctt

SEQ ID NO: 4638 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gaaccagtagcagctgcgctt

SEQ ID NO: 4639 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cgagagaaccagtagcagctt

SEQ ID NO: 4640 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ccggagcgagagaaccagttt

SEQ ID NO: 4641 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gagaaccagtagcagctgctt

SEQ ID NO: 4642 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gagaaccagtagcagctgctt

SEQ ID NO: 4643 - RNA, 21 nt, synthetic construct
  source 1..21: mol_type = other RNA
  modified_base 1: mod_base = OTHER; note = 5'-monophosphate
  modified_base 2: mod_base = OTHER; note = 2'-deoxy-2'-fluoro ribonucleotide
  modified_base 4: mod_base = OTHER; note = 2'-deoxy-2'-fluoro ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 16: mod_base = OTHER; note = 2'-deoxy-2'-fluoro ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
gagaaccagtagcagctgctt

SEQ ID NO: 4644 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11..12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4645 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9: mod_base = OTHER; note = 2'-O-methyl ribonucleotide
  modified_base 10: mod_base = OTHER; note = 2'-deoxy-2'-fluoro ribonucleotide
  modified_base 11: mod_base = OTHER; note = 2'-O-methyl ribonucleotide
  modified_base 12..13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4646 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tttggtcgtggaggcccattt

SEQ ID NO: 4647 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtagcagctgcgctcgtgctt

SEQ ID NO: 4648 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agcggccgtcgtcggtgaatt

SEQ ID NO: 4649 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cgtcccgtccacccacttctt

SEQ ID NO: 4650 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tgctcctcccaggacgtgatt

SEQ ID NO: 4651 - RNA, 21 nt, synthetic construct
  source 1..21: mol_type = other RNA
  modified_base 1: mod_base = OTHER; note = 5'-monophosphate
  misc_feature 21: note = invAb
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 21: mod_base = OTHER; note = phosphorothioate internucleotide linkage
acttcatctttcttcccactt

SEQ ID NO: 4652 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 3..4: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4653 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4654 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 18..19: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4655 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4656 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4657 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
acttcatctttcttcccactt

SEQ ID NO: 4658 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gacgtcgtcgttccagcggtt

SEQ ID NO: 4659 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gcacgccaaacgtggcatctt

SEQ ID NO: 4660 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
attgcctccctgggtgctctt

SEQ ID NO: 4661 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ctccctgggtgctcaagcctt

SEQ ID NO: 4662 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agcgacttcatctttcttctt

SEQ ID NO: 4663 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acgccaaacgtggcatctctt

SEQ ID NO: 4664 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cgtctcgtagtccgtcccgtt

SEQ ID NO: 4665 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cttgaagcccgtctcgtagtt

SEQ ID NO: 4666 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ggcatctccagtgcccgggtt

SEQ ID NO: 4667 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gaaagcgccacgggtttcatt

SEQ ID NO: 4668 - RNA, 20 nt, synthetic construct
  source 1..20: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..10: mod_base = OTHER; note = 2'-O-methyl ribonucleotide
  modified_base 11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 9..10: mod_base = OTHER; note = phosphorothioate internucleotide linkage
  modified_base 18..19: mod_base = OTHER; note = phosphorothioate internucleotide linkage
  modified_base 19..20: mod_base = OTHER; note = phosphorothioate internucleotide linkage
ctcccaggcgtgaccacctt

SEQ ID NO: 4669 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ggtgctggacaaatttctgtt

SEQ ID NO: 4670 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agcacgccaaacgtggcattt

SEQ ID NO: 4671 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tctctcaggccccgcagcttt

SEQ ID NO: 4672 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tccttggtcatgatagggctt

SEQ ID NO: 4673 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tgctcgctgtgaagttgcttt

SEQ ID NO: 4674 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tgctggacaaatttctgcttt

SEQ ID NO: 4675 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
cacttccagggcccgtttttt

SEQ ID NO: 4676 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gccatctgacagctcaggctt

SEQ ID NO: 4677 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gccaaacgtggcatctccatt

SEQ ID NO: 4678 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ttgaagcccgtctcgtagttt

SEQ ID NO: 4679 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ccgtcccgtccacccactttt

SEQ ID NO: 4680 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ggttcttcagtgctgtgcatt

SEQ ID NO: 4681 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
agcccgtctcgtagtccgttt

SEQ ID NO: 4682 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
gtggccgtaccagtcgtcctt

SEQ ID NO: 4683 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
ctctcaggccccgcagctctt

SEQ ID NO: 4684 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
tccaagcacgccaaacgtgtt

SEQ ID NO: 4685 - RNA, 21 nt, synthetic construct
  source 1..21: mol_type = other RNA
  modified_base 1: mod_base = OTHER; note = 5'-monophosphate
  misc_feature 1: note = invAb
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 6..7: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4686 - RNA, 21 nt, synthetic construct
  source 1..21: mol_type = other RNA
  modified_base 1: mod_base = OTHER; note = 5'-monophosphate
  misc_feature 1: note = invAb
  misc_feature 21: note = invAb
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6..7: mod_base = OTHER; note = 2'-deoxy-2'-fluoro ribonucleotide
  modified_base 8..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 6..7: mod_base = OTHER; note = phosphorothioate internucleotide linkage
  modified_base 21: mod_base = OTHER; note = phosphorothioate internucleotide linkage
acttcatctttcttcccactt

SEQ ID NO: 4687 - RNA, 21 nt, synthetic construct
  source 1..21: mol_type = other RNA
  modified_base 1: mod_base = OTHER; note = 5'-monophosphate
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..12: mod_base = OTHER; note = 2'-O-methyl ribonucleotide
  modified_base 13..14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt

SEQ ID NO: 4688 - RNA, 19 nt, synthetic construct
  source 1..19: mol_type = other RNA
  modified_base 6: mod_base = OTHER; note = Thymine
  modified_base 11: mod_base = OTHER; note = Thymine
  modified_base 14: mod_base = OTHER; note = Thymine
  modified_base 16..17: mod_base = OTHER; note = Thymine
caggctggagtgatcttca

SEQ ID NO: 4689 - RNA, 19 nt, synthetic construct
  source 1..19: mol_type = other RNA
  modified_base 1..2: mod_base = OTHER; note = Thymine
  modified_base 10..11: mod_base = OTHER; note = Thymine
ttcagcaacttcacagcga

SEQ ID NO: 4690 - skipped

SEQ ID NO: 4691 - RNA, 16 nt, synthetic construct
  source 1..16: mol_type = other RNA
  modified_base 6..7: mod_base = OTHER; note = Thymine
  modified_base 11: mod_base = OTHER; note = Thymine
  modified_base 15: mod_base = OTHER; note = Thymine
ccacattgcctccctg

SEQ ID NO: 4692 - RNA, 22 nt, synthetic construct
  source 1..22: mol_type = other RNA
  modified_base 2..6: mod_base = OTHER; note = Thymine
  modified_base 9: mod_base = OTHER; note = Thymine
  modified_base 21: mod_base = OTHER; note = Thymine
gtttttgatccagacccagatg

SEQ ID NO: 4693 - RNA, 21 nt, synthetic construct
  source 1..21: mol_type = other RNA
  modified_base 6..7: mod_base = OTHER; note = Thymine
  modified_base 9..10: mod_base = OTHER; note = Thymine
  modified_base 20: mod_base = OTHER; note = Thymine
gcccattattcagagcgagta

SEQ ID NO: 4694 - skipped

SEQ ID NO: 4695 - RNA, 14 nt, synthetic construct
  source 1..14: mol_type = other RNA
  modified_base 1: mod_base = OTHER; note = Thymine
  modified_base 10: mod_base = OTHER; note = Thymine
tcaccaggatccac

SEQ ID NO: 4696 - protein, 448 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDSSPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4697 - protein, 214 aa, synthetic construct
DIQMTQSPSSVSASVGDRVTITCRASQGISSWLAWYQQKPGKAPKLLIYGASSLQSGVPSRFSASGSGTDFTLTISSLQPEDFATYYCQQSDSFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4698 - RNA, 21 nt, synthetic construct
  source 1..21: mol_type = other RNA
  modified_base 1: mod_base = OTHER; note = 2'-deoxy-2'-fluoro ribonucleotide
  modified_base 2: mod_base = OTHER; note = 2'-O-methyl ribonucleotide
  modified_base 3: mod_base = OTHER; note = 2'-deoxy-2'-fluoro ribonucleotide
  modified_base 4: mod_base = OTHER; note = 2'-O-methyl ribonucleotide
  modified_base 5: mod_base = OTHER; note = 2'-deoxy-2'-fluoro ribonucleotide
  modified_base 6: mod_base = OTHER; note = 2'-O-methyl ribonucleotide
  modified_base 7: mod_base = OTHER; note = 2'-deoxy-2'-fluoro ribonucleotide
  modified_base 8: mod_base = OTHER; note = 2'-O-methyl ribonucleotide
  modified_base 9..11: mod_base = OTHER; note = 2'-deoxy-2'-fluoro ribonucleotide
  modified_base 12: mod_base = OTHER; note = 2'-O-methyl ribonucleotide
  modified_base 13: mod_base = OTHER; note = 2'-deoxy-2'-fluoro ribonucleotide
  modified_base 14: mod_base = OTHER; note = 2'-O-methyl ribonucleotide
  modified_base 15: mod_base = OTHER; note = 2'-deoxy-2'-fluoro ribonucleotide
  modified_base 16: mod_base = OTHER; note = 2'-O-methyl ribonucleotide
  modified_base 17: mod_base = OTHER; note = 2'-deoxy-2'-fluoro ribonucleotide
  modified_base 18: mod_base = OTHER; note = 2'-O-methyl ribonucleotide
  modified_base 19: mod_base = OTHER; note = 2'-deoxy-2'-fluoro ribonucleotide
  modified_base 20: mod_base = OTHER; note = 2'-O-methyl ribonucleotide
  modified_base 21: mod_base = OTHER; note = 2'-deoxy-2'-fluoro ribonucleotide
  modified_base 1..2: mod_base = OTHER; note = phosphorothioate internucleotide linkage
  modified_base 2..3: mod_base = OTHER; note = phosphorothioate internucleotide linkage
gtgggaagaaagatgaagttt

SEQ ID NO: 4699 - RNA, 21 nt, synthetic construct
  source 1..21: mol_type = other RNA
  modified_base 1: mod_base = OTHER; note = 2'-O-methyl ribonucleotide
  modified_base 2: mod_base = OTHER; note = 2'-deoxy-2'-fluoro ribonucleotide
  modified_base 3: mod_base = OTHER; note = 2'-O-methyl ribonucleotide
  modified_base 4: mod_base = OTHER; note = 2'-deoxy-2'-fluoro ribonucleotide
  modified_base 5: mod_base = OTHER; note = 2'-O-methyl ribonucleotide
  modified_base 6: mod_base = OTHER; note = 2'-deoxy-2'-fluoro ribonucleotide
  modified_base 7: mod_base = OTHER; note = 2'-O-methyl ribonucleotide
  modified_base 8: mod_base = OTHER; note = 2'-deoxy-2'-fluoro ribonucleotide
  modified_base 9..11: mod_base = OTHER; note = 2'-O-methyl ribonucleotide
  modified_base 12: mod_base = OTHER; note = 2'-deoxy-2'-fluoro ribonucleotide
  modified_base 13: mod_base = OTHER; note = 2'-O-methyl ribonucleotide
  modified_base 14: mod_base = OTHER; note = 2'-deoxy-2'-fluoro ribonucleotide
  modified_base 15: mod_base = OTHER; note = 2'-O-methyl ribonucleotide
  modified_base 16: mod_base = OTHER; note = 2'-deoxy-2'-fluoro ribonucleotide
  modified_base 17: mod_base = OTHER; note = 2'-O-methyl ribonucleotide
  modified_base 18: mod_base = OTHER; note = 2'-deoxy-2'-fluoro ribonucleotide
  modified_base 19: mod_base = OTHER; note = 2'-O-methyl ribonucleotide
  modified_base 20: mod_base = OTHER; note = 2'-deoxy-2'-fluoro ribonucleotide
  modified_base 21: mod_base = OTHER; note = 2'-O-methyl ribonucleotide
  modified_base 1..2: mod_base = OTHER; note = phosphorothioate internucleotide linkage
  modified_base 2..3: mod_base = OTHER; note = phosphorothioate internucleotide linkage
  modified_base 19..20: mod_base = OTHER; note = phosphorothioate internucleotide linkage
  modified_base 20..21: mod_base = OTHER; note = phosphorothioate internucleotide linkage
acttcatctttcttcccactt
